United States Patent 11,931,406 (FLAVIVIRUS VACCINE) - sequence listing, part 31

SEQ ID NO: 12517 - RNA, 9873 nt, Artificial Sequence
  derived and/or modified CDS sequence (opt2) from DENV-3__GU131844__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacgucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccgcccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucgcccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcuccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucgccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12518 - RNA, 9873 nt, Artificial Sequence
  derived and/or modified CDS sequence (opt2) from DENV-3__GU131849__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccaugcuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacucccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12519 - RNA, 9873 nt, Artificial Sequence
  derived and/or modified CDS sequence (opt2) from DENV-3__GQ868546__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12520 - RNA, 9873 nt, Artificial Sequence
  derived and/or modified CDS sequence (opt2) from DENV-3__GU131850__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaucaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaucggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaacuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagaagggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12521 - RNA, 9873 nt, Artificial Sequence
  derived and/or modified CDS sequence (opt2) from DENV-3__GU131851__SS-prME
accucccucugccucgucaugauccuccccgccgcccucgccuuccaccucaccucccgcgacggcgagccccacaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccaguggcucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12522 - RNA, 9873 nt, Artificial Sequence
  derived and/or modified CDS sequence (opt2) from DENV-3__GQ868547__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagauggucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagguccacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12523 - RNA, 9873 nt, Artificial Sequence
  derived and/or modified CDS sequence (opt2) from DENV-3__GU131857__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12524 - RNA, 9873 nt, Artificial Sequence
  derived and/or modified CDS sequence (opt2) from DENV-3__GU131858__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaucaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaucggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcaccuccggccccucccucaccaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaacuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12525 - RNA, 9873 nt, Artificial Sequence
  derived and/or modified CDS sequence (opt2) from DENV-3__GQ868548__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12526 - RNA, 9873 nt, Artificial Sequence
  derived and/or modified CDS sequence (opt2) from DENV-3__GU131861__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgucaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccgucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagcgcaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagaagaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12527 - RNA, 9873 nt, Artificial Sequence
  derived and/or modified CDS sequence (opt2) from DENV-3__GU131862__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaucaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaucggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucacccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaacuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggaagacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12528 - RNA, 9873 nt, Artificial Sequence
  derived and/or modified CDS sequence (opt2) from DENV-3__GU131865__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgucaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccgucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagcgcaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucaugaccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12529 - RNA, 9873 nt, Artificial Sequence
  derived and/or modified CDS sequence (opt2) from DENV-3__GU131866__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgaccgccgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacgccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgcaagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12530 - RNA, 9873 nt, Artificial Sequence
  derived and/or modified CDS sequence (opt2) from DENV-3__GU131868__SS-prME
accccccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaacaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaaggccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccuccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccuccgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccgucuuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12531 - RNA, 9873 nt, Artificial Sequence
  derived and/or modified CDS sequence (opt2) from DENV-3__GU131869__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaucgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccacccgcuccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12532 - RNA, 9873 nt, Artificial Sequence
  derived and/or modified CDS sequence (opt2) from DENV-3__GU131870__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaaccacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaucgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccucgucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12533 - RNA, 9873 nt, Artificial Sequence
  derived and/or modified CDS sequence (opt2) from DENV-3__GU131871__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccaccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagcgcaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12534 - RNA, 9873 nt, Artificial Sequence
  derived and/or modified CDS sequence (opt2) from DENV-3__GU131872__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagauggucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccacccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12535 - RNA, 9873 nt, Artificial Sequence
  derived and/or modified CDS sequence (opt2) from DENV-3__GU131873__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucgucaucaccguccacaccggcgaccagcaccaggucggcaacgagacccagggcaucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacgucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuucaucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12536 - RNA, 9873 nt, Artificial Sequence
  derived and/or modified CDS sequence (opt2) from DENV-3__GU131874__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccaccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccgcccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucgcccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcuccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucgccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12537 - RNA, 9873 nt, Artificial Sequence
  derived and/or modified CDS sequence (opt2) from DENV-3__GU131875__SS-prME
accucccucugccucgucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaugacccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggucgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12538 - RNA, 9873 nt, Artificial Sequence
  derived and/or modified CDS sequence (opt2) from DENV-3__GU131877__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguaccgcggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgucauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucaucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucauccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucuccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucauccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12539 - RNA, 9873 nt, Artificial Sequence
  derived and/or modified CDS sequence (opt2) from DENV-3__GU131878__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcgccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcucaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgccaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12540 - RNA, 9873 nt, Artificial Sequence
  derived and/or modified CDS sequence (opt2) from DENV-3__FJ898455__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacgucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggccguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaccuccggcggcaccuccaucuucgccggccaccucaagugccgccucaagauggacaagcucgagcucaagggcauguccuacgccaugugccucaacgccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccaucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccaucgucgucggcgacgucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagauguacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggccgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaugugcuccaacaccaucuucacccucaccgucgccuggcgcaccgccacccucauccucgccgucaucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccuccuuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccacaaggagggcgucuuccacaccauguggcacgucacccgcggcgccguccucacccacaacggcaagcgccucgagcccaacugggccaacgucaagaaggaccucaucuccuacggcggcggcuggaagcucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucgucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggccuucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcauccgccgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaucaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccucgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagaugugggcccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12541 - RNA, 9873 nt, Artificial Sequence
  derived and/or modified CDS sequence (opt2) from DENV-3__GQ199891__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12542 - RNA, 9873 nt, Artificial Sequence
  derived and/or modified CDS sequence (opt2) from DENV-3__FJ898443__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaugaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggagcucgagggcgccaucugguga

SEQ ID NO: 12543 - RNA, 9873 nt, Artificial Sequence
  derived and/or modified CDS sequence (opt2) from DENV-3__FJ898444__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacgagcagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcaugucccgcgagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagaagggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12544 - RNA, 9873 nt, Artificial Sequence
  derived and/or modified CDS sequence (opt2) from DENV-3__FJ898445__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagcgcgaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggauggagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggcaugcucgagaccaccaagcgcgaccucggcauguccaaggagcccggcgucgccucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucauccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucacccgcaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12545 - RNA, 9873 nt, Artificial Sequence
  derived and/or modified CDS sequence (opt2) from DENV-3__GQ868571__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggcaugcucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12546 - RNA, 9873 nt, Artificial Sequence
  derived and/or modified CDS sequence (opt2) from DENV-3__GU131951__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauguccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgaggcccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucacccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaucgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12547 - RNA, 9873 nt, Artificial Sequence
  derived and/or modified CDS sequence (opt2) from DENV-3__GQ868572__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaagguccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12548 - RNA, 9873 nt, Artificial Sequence
  derived and/or modified CDS sequence (opt2) from DENV-3__GQ868573__SS-prME
accuccuucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggccuccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12549 - RNA, 9873 nt, Artificial Sequence
  derived and/or modified CDS sequence (opt2) from DENV-3__GQ868574__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucuccuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggcaugcucgagaccaccaagcgcgaccucggcauguccaaggagcccggcgucgccucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12550 - RNA, 9873 nt, Artificial Sequence
  derived and/or modified CDS sequence (opt2) from DENV-3__GQ868575__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuucuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgacaagaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcaugucccgcgagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagauccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12551 - RNA, 9873 nt, Artificial Sequence
  derived and/or modified CDS sequence (opt2) from DENV-3__GU131953__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggccgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacgccguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12552 - RNA, 9873 nt, Artificial Sequence
  derived and/or modified CDS sequence (opt2) from DENV-3__GQ868577__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucgcccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggagaacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12553 - RNA, 9873 nt, Artificial Sequence
  derived and/or modified CDS sequence (opt2) from DENV-3__GU131954__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgucaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcaugaccaaggagcccggcgccgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaaggucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12554 - RNA, 9873 nt, Artificial Sequence
  derived and/or modified CDS sequence (opt2) from DENV-3__GQ868578__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaaguggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaccuccgagaaggaggagaacauggucaagucccucgucuccgccggcuccggcgaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaagaucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccacccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucgcccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaugggcaacgaggaguuccucgacuacaugcccuccaugaagcgcuuccgcaaggaggaggaguccgagggcgccaucugguga

SEQ ID NO: 12555 - RNA, 9873 nt, Artificial Sequence
  derived and/or modified CDS sequence (opt2) from DENV-3__FJ898457__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaagaccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12556 - RNA, 9873 nt, Artificial Sequence
  derived and/or modified CDS sequence (opt2) from DENV-3__KF955505__SS-prME
accucccucugccucaugaugauccuccccgccgcccucgccuuccaccucaccucccgcaacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcccccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccccaagcucggcuacauccuccgcgacaucuccaagauccccggcggcgccauguacgccgacgacaccgccggcugggacacccgcaucaccgaggacgaccuccacaacgaggagaagaucccccaccagauggaccccgagcacucccgccucgccaacgccaucuucaagcucaccuaccagaacaaggucgucaagguccagcgccccacccccaccggcaccgucauggacaucaucucccgcaaggcccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucaccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12557 - RNA, 9873 nt, Artificial Sequence
  derived and/or modified CDS sequence (opt2) from DENV-3__FJ898464__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12558 - RNA, 9873 nt, Artificial Sequence
  derived and/or modified CDS sequence (opt2) from DENV-3__JQ922556__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggcccccgcccgcggcgcccgccgcauggccauccucggcgacaccgccugggucuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccuccacccccgagugccccuccgccucccgcgccuggaacgucugggaggucgaggacuacggcuucggcgucuucaccaccaacaucuggcucaagcuccgcgaggucuacacccagaugugcgaccaccgccucaugucccccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggccuucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucggcaccggcaccuccgccgaccucaccgucgagcaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccccccaguggcagaagggcgaggagguccaggucaucaccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaaccgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgagaccgaguaccagaagaccaagcucaacgacugggacuucgucggcaccaccgacaucuccgagaugggcgccaacuucaaggccgaccgcgucaucgacccccgccgcugccucaagcccggcauccucaccgacggccccgagggcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaucaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcgucuccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagcucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccggcuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcggccgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacugggucaccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12559 - RNA, 9873 nt, Artificial Sequence
  derived and/or modified CDS sequence (opt2) from DENV-3__JQ922557__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagcgccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaugugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcaaguccaagcgcgacaacuccaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccucaugcucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccuccucaucaccgucgacgacaacggcaccaugcgcaucaaggacgacgagaccgagaucauccucaccguccuccucaagaccgcccuccagaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcgacuaccucuccggcaucgcccagaccaacgccgagcccuacggccccucccccgaccucgaggaggagauguucaagaagcgcaagcucaccaucauggaccuccaccccggcuccggccagacccucaaguaccuccccgccaucguccgcgacgccaucaagcgccgccuccgcauccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgccgagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgagaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccaagcgcgucauccucgccggccccaugcccgacaccgccgccuccgccgcccagcgccgcggccgcgucggccgcaacccccagaaggagaacgaccaguacaucuuccccggccagccccucaacaccgacgaggaccacgcccacuggcccgagaccaagcuccucauggaccucuucaccacccccgagggcauccuccccucccacuucgacccccacggcgagaacuuccccgagaucuccggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgacucccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaucaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaugaccacccucugggagggcucccccggcaagaucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccgccgucaucgagcaccucgagcgccuccagcgcaagcacggcggcaugcucguccgcaacccccucucccgcaacuccacccacgagaugcacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccuccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacccccccuaccucggcaagcgcgaggaccaguggugcggcuccaucaucggccucuccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12560 - RNA, 9873 nt, Artificial Sequence
  derived and/or modified CDS sequence (opt2) from DENV-3__JQ922555__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgagacccagggcgucaccgccgagaucaccccccaggccuccaccgccgaggccauccuccccgaguacggcacccucggccucgagugcuccccccgcaccggccucgacuucaacgagaugauccuccucaccaugaagaacaaggccuggaugggccaccgccagaugcucuucgaccuccccacccccuggaccuccggcaccaccaccgagaccuccgccuggaaccgcaaggagcccuucgucaccuucaagaacgcccacaccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucgucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguaccgcaagggcuccuccaucggcaagauguucgaggccaccucccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagaucugcgaccaccgccucauguccgccgccgucaaggacgagcgcgccguccacgccgacaugggcuacuggaucgagucccagaagaacggcuccuggaagcucgagaaggccucccucaucgaggucaagaccuccaccuggcccaagucccacacccucugguccaacggcguccaggaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgccuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccgcacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacggcguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccuccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgacgccaagaugcuccucgagaacaucaacacccccgagggcaucauccccgcccucuucgagcccgagcgcgagaaguccgccggccucgacggcgaguaccgccucaagggcgagucccgcaagaccuucgucgagcucaugcgccgcggcgaccuccccgucuggcucgcccacaaggucgccuccgagggcauccucuacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcgucuccucccaccucgcccaccgcacccgcaacgcccucgacaacaagaugaugcuccacaccuccgaguacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcgucuccaaggagcccggcgucgucucccccaccuccuaccucgacgucgaccuccaccccgccuccgccuggacccucuacgccgucgccaccaccgucaucgcccccaugcuccgccacaccaucgagaacuccaccgccaacgucuccauggccgccaucgccaaccaggccgucguccucaugggccucgacaagggcuggcccaucuccaagauggaccucggcgucccccuccucgcccucggcugcuacuucuacgucaacccccucacccucaccgccgccgucuuccuccucgucacccacuacgccaucaucggccccggccuccaggccaaggccacccgcgaggcccacaagaagaccgccgccggcaucaugaaccccccccccggcgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaccaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggcaagggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacucccgcaacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccucaugccccgcacccgcaaggucauggagaucaccgccgaguggcucuggcgcacccucggccgcaacaagcgcccccgccucugcacccgcgaggaguucaccaagaagguccgccccaucgccgccaugggcgccgucuucacccagcgcgaccagugggacuccgccaaggccgccgucgaggacgaggaguucuggaagcccgucgaccgcgagugcaacucccaccagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaacaccgaggacgaccuccacaugaaggagaagaucacccagcagaugggccccggccacucccgccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12561 - RNA, 9873 nt, Artificial Sequence
  derived and/or modified CDS sequence (opt2) from DENV-3__GU131903__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacuccggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaaggccggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacauggccaccggcaucgagcaccucgagcgccuccagcgcaaguacggcggcaugcucguccgcaacccccucucccgcaacuccacccacgagauggacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12562 - RNA, 9873 nt, Artificial Sequence
  derived and/or modified CDS sequence (opt2) from DENV-3__GU131904__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacuccaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccuccgcaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccauggccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12563 - RNA, 9873 nt, Artificial Sequence
  derived and/or modified CDS sequence (opt2) from DENV-3__GU131906__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacaccccccgccgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucggcaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12564 - RNA, 9873 nt, Artificial Sequence
  derived and/or modified CDS sequence (opt2) from DENV-3__GU131907__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaccgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggagaccgagggcgccaucugguga

SEQ ID NO: 12565 - RNA, 9873 nt, Artificial Sequence
  derived and/or modified CDS sequence (opt2) from DENV-3__GQ868634__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12566 - RNA, 9873 nt, Artificial Sequence
  derived and/or modified CDS sequence (opt2) from DENV-3__GU131908__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccuggaagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12567 - RNA, 9873 nt, Artificial Sequence
  derived and/or modified CDS sequence (opt2) from DENV-3__GU131909__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggccuuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12568 - RNA, 9873 nt, Artificial Sequence
  derived and/or modified CDS sequence (opt2) from DENV-3__GU131912__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccaacaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccaucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcuccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgcaaguccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccuccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccuccgcauggucgagcccuggcuccgcaacaaccaguucugcaucaagguccucaaccccuacaugcccaacgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccgaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12569 - RNA, 9873 nt, Artificial Sequence
  derived and/or modified CDS sequence (opt2) from DENV-3__GU131913__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccaucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucgucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagguccacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgcaaguccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaacgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccgaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggaugggcgacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12570 - RNA, 9873 nt, Artificial Sequence
  derived and/or modified CDS sequence (opt2) from DENV-3__GU131914__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccaucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgagguccacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgcaaguccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaacgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccgaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggaugggcgacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12571 - RNA, 9873 nt, Artificial Sequence
  derived and/or modified CDS sequence (opt2) from DENV-3__GU131915__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggccgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacuccggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12572 - RNA, 9873 nt, Artificial Sequence
  derived and/or modified CDS sequence (opt2) from DENV-3__GU131916__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucaucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccuccggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgaggacguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguucuccgacuacaugcccuccaugaagcgcuuccgcaaggaggaggaguccgagggcgccaucugguga

SEQ ID NO: 12573 - RNA, 9873 nt, Artificial Sequence
  derived and/or modified CDS sequence (opt2) from DENV-3__GU131917__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcuccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucauccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucuccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12574 - RNA, 9873 nt, Artificial Sequence
  derived and/or modified CDS sequence (opt2) from DENV-3__GU131918__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcuccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucauccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucuccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12575 - RNA, 9873 nt, Artificial Sequence
  derived and/or modified CDS sequence (opt2) from DENV-3__GU131933__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacuccaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaugggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccauggccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12576 - RNA, 9873 nt, Artificial Sequence
  derived and/or modified CDS sequence (opt2) from DENV-3__GU131934__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccuggaucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcgucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagaaccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccauccccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggagaccgagggcgccaucugguga

SEQ ID NO: 12577 - RNA, 9873 nt, Artificial Sequence
  derived and/or modified CDS sequence (opt2) from DENV-3__GU131935__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgucaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcaccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12578 - RNA, 9873 nt, Artificial Sequence
  derived and/or modified CDS sequence (opt2) from DENV-3__GU131936__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcgcccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugaagaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcuccaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggagaccgagggcgccaucugguga

SEQ ID NO: 12579 - RNA, 9873 nt, Artificial Sequence
  derived and/or modified CDS sequence (opt2) from DENV-3__GU131937__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccacccuccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugaucucccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagaaccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12580 - RNA, 9873 nt, Artificial Sequence
  derived and/or modified CDS sequence (opt2) from DENV-3__GU131938__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcgcccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugaagaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaugggccagccccucaacaacgacgaggaccacgcccacuggaccgaggccaagaugcuccucgacaacaucaacacccccgaggccaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcuccaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggagaccgagggcgccaucugguga

SEQ ID NO: 12581 - RNA, 9873 nt, Artificial Sequence
  derived and/or modified CDS sequence (opt2) from DENV-3__GU131939__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccaucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgcaaguccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagcgcgucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaacgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccgaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12582 - RNA, 9873 nt, Artificial Sequence
  derived and/or modified CDS sequence (opt2) from DENV-3__GU131940__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcaccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12583 - RNA, 9873 nt, Artificial Sequence
  derived and/or modified CDS sequence (opt2) from DENV-3__GU131942__SS-prME
accucccucugccucaugaugauguuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacuccggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccgucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcgccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12584 - RNA, 9873 nt, Artificial Sequence
  derived and/or modified CDS sequence (opt2) from DENV-3__GU131943__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaucuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucugggccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12585 - RNA, 9873 nt, Artificial Sequence
  derived and/or modified CDS sequence (opt2) from DENV-3__GU131945__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcgcccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugaagaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcuccaaccaguucugcaucaagguccucaaccccuacaugcccaccgucaucgaguaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggagaccgagggcgccaucugguga

SEQ ID NO: 12586 - RNA, 9873 nt, Artificial Sequence
  derived and/or modified CDS sequence (opt2) from DENV-3__GU131946__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcauccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggcccgcaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuuccucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcuccgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacaacgcccgcgccgccgucgaggacgaggaguucuggaagcucgucgaccgcgagcgcgagcuccacaagcucggcaagugcggcuccugcaucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgaccgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12587 - RNA, 9873 nt, Artificial Sequence
  derived and/or modified CDS sequence (opt2) from DENV-3__FJ639712__SS-prME
accucccucugccucaugaugauguuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacuccggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgagugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacgccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12588 - RNA, 9873 nt, Artificial Sequence
  derived and/or modified CDS sequence (opt2) from DENV-3__FJ639713__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcuccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucauccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucuccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12589 - RNA, 9873 nt, Artificial Sequence
  derived and/or modified CDS sequence (opt2) from DENV-3__FJ639714__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggaguccggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccaucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccggccaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggagaccgagggcgccaucugguga

SEQ ID NO: 12590 - RNA, 9873 nt, Artificial Sequence
  derived and/or modified CDS sequence (opt2) from DENV-3__FJ639715__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccaacaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccaucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgcaaguccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaacgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccgaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12591 - RNA, 9873 nt, Artificial Sequence
  derived and/or modified CDS sequence (opt2) from DENV-3__KF955461__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccaggucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgccaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccagcucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12592 - RNA, 9873 nt, Artificial Sequence
  derived and/or modified CDS sequence (opt2) from DENV-3__FJ639719__SS-prME
accucccucugccucaugaugaugcuccccgccacccucgccuuccaccucaccucccgcgacggcgagccccgcaugaucgucggcaagaacgagcgcggcaagucccuccucuucaagaccgccaccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucacccaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucgucuccggcaagggcaucggcaagaccaccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaacaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12593 - RNA, 9873 nt, Artificial Sequence
  derived and/or modified CDS sequence (opt2) from DENV-3__KF955332__SS-prME
accucccucugccucaugaugaugcuccccgccacccucgccuuccaccucaccucccgcgacggcgagccccgcaugaucgucggcaagaacgagcgcggcaagucccuccucuucaagaccgccaccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacgcccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucgucuccggcaagggcaucggcaagaccaccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccucgagaagaagaucacccaguggcucgagaacaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12594 - RNA, 9873 nt, Artificial Sequence
  derived and/or modified CDS sequence (opt2) from DENV-3__FJ639720__SS-prME
accucccucugccucaugaugaugcuccccgccacccucgccuuccaccucaccucccgcgacggcgagccccgcaugaucgucggcaagaacgagcgcggcaagucccuccucuucaagaccgccaccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccuccgcaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgccaucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucgucuccggcaagggcaucggcaagaccaccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccucgagaagaagaucacccaguggcucgagaacaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12595 - RNA, 9873 nt, Artificial Sequence
  derived and/or modified CDS sequence (opt2) from DENV-3__GQ868626__SS-prME
accucccucugccucaugaugaugcuccccgccacccucgccuuccaccucaccucccgcgacggcgagccccgcaugaucgucggcaagaacgagcgcggcaagucccuccucuucaagaccgccaccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaucgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccuccgcaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccaccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaacaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucgccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12596 - RNA, 9873 nt, Artificial Sequence
  derived and/or modified CDS sequence (opt2) from DENV-3__GQ868627__SS-prME
accucccucugccucaugaugaugcuccccgccacccucgccuuccaccucaccucccgcgacggcgagccccgcaugaucgucggcaagaacgagcgcggcaagucccuccucuucaagaccgccaccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccuccgcaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccaccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaacaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucgccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12597 - RNA, 9873 nt, Artificial Sequence
  derived and/or modified CDS sequence (opt2) from DENV-3__FJ639721__SS-prME
accucccucugccucaugaugaugcuccccgccacccucgccuuccaccucaccucccgcgacggcgagccccgcaugaucgucggcaagaacgagcgcggcaagucccuccucuucaagaccgccaccggcaucaacaugugcacccucaucgccauggaccucggcgagaugugcgacgacaccgucaccuacaagugcccccucaucgucgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucacccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacgcccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucgucuccggcaagggcaucggcaagaccaccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccucgagaagaagaucacccaguggcucgagaacaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12598 - RNA, 9873 nt, Artificial Sequence
  derived and/or modified CDS sequence (opt2) from DENV-3__FJ639722__SS-prME
accucccucugccucaugaugaugcuccccgccacccucgccuuccaccucaccucccgcgacggcgagccccgcaugaucgucggcaagaacgagcgcggcaagucccuccucuucaagaccgccaccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgagaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacgcccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucgucuccggcaagggcaucggcaagaccaccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaagaccgaccucgagaacccccaccuccucgagaagaagaucacccaguggcucgagaacaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12599 - RNA, 9873 nt, Artificial Sequence
  derived and/or modified CDS sequence (opt2) from DENV-3__FJ639723__SS-prME
accucccucugccucaugaugaugcuccccgccacccucgccuuccaccucaccucccgcgacggcgagccccgcaugaucgucggcaagaacgagcgcggcaagucccuccucuucaagaccgccaccggcaucaacaugugcacccucaucgccauggaccucggcgagaugugcgacgacaccgucaccuacaagugcccccucaucgccgaggucgagcccgaggacaucgacugcuggugcaaccucaccuccgccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucauccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccuccgcaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaccaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgccuacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccaccaucggccucaucugcgucaucgucuccuccggcaugcucuggauggccgacaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuuccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaacaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucgccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12600 - RNA, 9873 nt, Artificial Sequence
  derived and/or modified CDS sequence (opt2) from DENV-3__FJ639724__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagcgcgucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccaccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12601 - RNA, 9873 nt, Artificial Sequence
  derived and/or modified CDS sequence (opt2) from DENV-3__FJ639725__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucggcaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12602 - RNA, 9873 nt, Artificial Sequence
  derived and/or modified CDS sequence (opt2) from DENV-3__FJ639726__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagcgcgucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucucccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12603 - RNA, 9873 nt, Artificial Sequence
  derived and/or modified CDS sequence (opt2) from DENV-3__KF955333__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccgcccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaagcccgccgacguccccugggaggaggaggccgagcagaccggcgucucccacaaccucaugaucaccgucgacgacgacggccccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucaccgcccagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12604 - RNA, 9873 nt, Artificial Sequence
  derived and/or modified CDS sequence (opt2) from DENV-3__GQ868628__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcgccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12605 - RNA, 9873 nt, Artificial Sequence
  derived and/or modified CDS sequence (opt2) from DENV-3__FJ639727__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaagucccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuacuacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgcccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucgucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuuccgcgccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12606 - RNA, 9873 nt, Artificial Sequence
  derived and/or modified CDS sequence (opt2) from DENV-3__GQ868629__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12607 - RNA, 9873 nt, Artificial Sequence
  derived and/or modified CDS sequence (opt2) from DENV-3__FJ639728__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgcccuccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12608 - RNA, 9873 nt, Artificial Sequence
  derived and/or modified CDS sequence (opt2) from DENV-3__FJ639729__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaucaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggaaccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12609 - RNA, 9873 nt, Artificial Sequence
  derived and/or modified CDS sequence (opt2) from DENV-3__FJ639730__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagaaggccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaacaaggagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgagcucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagaagcuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12610 - RNA, 9873 nt, Artificial Sequence
  derived and/or modified CDS sequence (opt2) from DENV-3__KF955464__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccauccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccaacaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccaucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcaacggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucgccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgcaaguccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccuccgcauggucgagcccuggcuccgcaacaaccaguucugcaucaagguccucaaccccuacaugcccaacgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccgaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccgcccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12611 - RNA, 9873 nt, Artificial Sequence
  derived and/or modified CDS sequence (opt2) from DENV-3__FJ639731__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccguccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagauggacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaacaaggagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12612 - RNA, 9873 nt, Artificial Sequence
  derived and/or modified CDS sequence (opt2) from DENV-3__HM181933__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgccaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgccgccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12613 - RNA, 9873 nt, Artificial Sequence
  derived and/or modified CDS sequence (opt2) from DENV-3__JF295012__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaaguccaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgacacccagggcgucaccgucgagaucaccccccaggccuccaccgucgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucgucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggccgccgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcuccgcaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggauccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12614 - RNA, 9873 nt, Artificial Sequence
  derived and/or modified CDS sequence (opt2) from DENV-3__FJ898463__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccaccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggaccacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12615 - RNA, 9873 nt, Artificial Sequence
  derived and/or modified CDS sequence (opt2) from DENV-3__GQ868616__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccaccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacucccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgcccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucacccccgaguggcucuggcgcccccucggccgcaacaagaagccccgccucugcccccgcgaggaguucaccaagaagguccgcaccaacgcccccaugggcgccgucuucaccgaggagacccagugggccuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccccaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12616 - RNA, 9873 nt, Artificial Sequence
  derived and/or modified CDS sequence (opt2) from DENV-3__GQ199887__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucgucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgccuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccauguucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguuccgcaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgucaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagcgcgacgucgaccucggcgccggcacccgccacgucaacgccgagcccgagauccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12617 - RNA, 9873 nt, Artificial Sequence
  derived and/or modified CDS sequence (opt2) from DENV-3__GQ199888__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucgucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgccuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccauguucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguuccgcaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagcgcgacgucgaccucggcgccggcacccgccacgucaacgccgagcccgagauccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgaggacguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12618 - RNA, 9873 nt, Artificial Sequence
  derived and/or modified CDS sequence (opt2) from DENV-3__GQ252674__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcaucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgacgucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccauccucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaacgccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagcgcggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccauccccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgcaaggucaugggcaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgacaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggagguccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggagaacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12619 - RNA, 9873 nt, Artificial Sequence
  derived and/or modified CDS sequence (opt2) from DENV-3__GQ199889__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucauccucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgccuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggcaugcucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccuccgccgagcccgacggccccacccccgagcucgaggaggagauguuccgcaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccgccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagcgcgacgucgaccucggcgccggcacccgccacgucaacgccgagcccgagauccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12620 - RNA, 9873 nt, Artificial Sequence
  derived and/or modified CDS sequence (opt2) from DENV-3__FJ882571__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgacgucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccauccucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaucgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucaugggcaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgacaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggagguccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcaugcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucgccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12621 - RNA, 9873 nt, Artificial Sequence
  derived and/or modified CDS sequence (opt2) from DENV-3__FJ882572__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgccuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggcaugcucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccuccgccgagcccgacggccccacccccgagcucgaggaggagauguuccgcaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagcgcgacgucgaccucggcgccggcacccgccacgucaacgccgagcccgagauccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12622 - RNA, 9873 nt, Artificial Sequence
  derived and/or modified CDS sequence (opt2) from DENV-3__FJ882573__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccugggccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacacccccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaccggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgaggucccccuccaguggaucgccuccgccaucguccucgaguucuucaugaugguccuccucauccccgagcccgagaagcagcgcaccccccaggacaaccagcucgccuacgucgucaucggcauccucacccucgccgccaugaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucguccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcgucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucauccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucaccaaggccgaccucgagaacccccaccuccucgagaagaagaucacccaguggcucgaggccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggagaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12623 - RNA, 9873 nt, Artificial Sequence
  derived and/or modified CDS sequence (opt2) from DENV-3__FJ898440__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaucaccgaggccauccuccccgaguacggcacccucggccucgagugcuccccccgcaccggccucgacuucaacgagaugguccuccucaccaugaagaacaaggccuggaugguccaccgccagugguucuucgaccucccccuccccuggaccuccggcgccaccaccgagacccccaucuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccagccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagaaggaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagaugaaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12624 - RNA, 9873 nt, Artificial Sequence
  derived and/or modified CDS sequence (opt2) from DENV-3__FJ898441__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaagaugguccaguacgagaaccucaaguacaccgucaucaucaccguccacaccggcgaccagcaccaggucggcaacgagacccagggcgucaccgccgagaucaccccccaggccuccaucaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccaccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccaggucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgucggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgccgacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccagccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagaaggaccucggcauguccaaggagcccggcgucgucuccuccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucaugaccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagcgcgacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgcaaggucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaccauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12625 - RNA, 9873 nt, Artificial Sequence
  derived and/or modified CDS sequence (opt2) from DENV-3__FJ898442__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaagaugguccaguacgagaaccucaaguacaccgucaucaucaccguccacaccggcgaccagcaccaggucggcaacgagacccagggcgucaccgccgagaucaccccccaggccuccaucaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccaccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccaggucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucaucccccgcucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgccgacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccagccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagaaggaccucggcauguccaaggagcccggcgucgucuccuccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucaugaccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagcgcgacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgcaaggucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaccauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgagaacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12626 - RNA, 9873 nt, Artificial Sequence
  derived and/or modified CDS sequence (opt2) from DENV-3__FJ882575__SS-prME
accucccucugccucaugaugauccuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcauccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucgacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucaugggcaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgccaaggccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12627 - RNA, 9873 nt, Artificial Sequence
  derived and/or modified CDS sequence (opt2) from DENV-3__GQ199886__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaugggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagaaggacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12628 - RNA, 9873 nt, Artificial Sequence
  derived and/or modified CDS sequence (opt2) from DENV-3__FJ882576__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucgccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12629 - RNA, 9873 nt, Artificial Sequence
  derived and/or modified CDS sequence (opt2) from DENV-3__FJ850052__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacaaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12630 - RNA, 9873 nt, Artificial Sequence
  derived and/or modified CDS sequence (opt2) from DENV-3__FJ873812__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucuccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12631 - RNA, 9873 nt, Artificial Sequence
  derived and/or modified CDS sequence (opt2) from DENV-3__FJ873813__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcuacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12632 - RNA, 9873 nt, Artificial Sequence
  derived and/or modified CDS sequence (opt2) from DENV-3__FJ850048__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12633 - RNA, 9873 nt, Artificial Sequence
  derived and/or modified CDS sequence (opt2) from DENV-3__FJ850049__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccaacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12634 - RNA, 9873 nt, Artificial Sequence
  derived and/or modified CDS sequence (opt2) from DENV-3__FJ898476__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12635 - RNA, 9873 nt, Artificial Sequence
  derived and/or modified CDS sequence (opt2) from DENV-3__FJ898475__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12636 - RNA, 9873 nt, Artificial Sequence
  derived and/or modified CDS sequence (opt2) from DENV-3__GQ199861__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccaacgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12637 - RNA, 9873 nt, Artificial Sequence
  derived and/or modified CDS sequence (opt2) from DENV-3__GQ199862__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcauccucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccgucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12638 - RNA, 9873 nt, Artificial Sequence
  derived and/or modified CDS sequence (opt2) from DENV-3__GQ199863__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggucauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaucuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12639 - RNA, 9873 nt, Artificial Sequence
  derived and/or modified CDS sequence (opt2) from DENV-3__GQ199864__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucaacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaucggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12640 - RNA, 9873 nt, Artificial Sequence
  derived and/or modified CDS sequence (opt2) from DENV-3__GQ199865__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccuggggcgaggaggccgagcagaccggcgucucccacaugcucaugaucaccgucgaggacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12641 - RNA, 9873 nt, Artificial Sequence
  derived and/or modified CDS sequence (opt2) from DENV-3__GQ199870__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguccuggaucuccaacggcaccggcaacaucgucgccuccgucaacauggucucccgccuccuccucaaccgcuccaccaugacccaccgccgccccaccaucgagaaggacgucgaccucggcgccggcccccgccacgucaacgccgaccccgagccccccaacauggacgucaucggcgagcgcaucaagcgcgucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucccccagauggccaugaccgacaccacccccuucggccagcagcgcgucuucaaggagaaggucgacacccgcaccccccgcuccauccccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12642 - RNA, 9873 nt, Artificial Sequence
  derived and/or modified CDS sequence (opt2) from DENV-3__JF937630__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacgccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12643 - RNA, 9873 nt, Artificial Sequence
  derived and/or modified CDS sequence (opt2) from DENV-3__JN000936__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucgucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucaccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgacgacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12644 - RNA, 9873 nt, Artificial Sequence
  derived and/or modified CDS sequence (opt2) from DENV-3__HQ541796__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaccgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccucaccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12645 - RNA, 9873 nt, Artificial Sequence
  derived and/or modified CDS sequence (opt2) from DENV-3__HQ166034__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcgccgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12646 - RNA, 9873 nt, Artificial Sequence
  derived and/or modified CDS sequence (opt2) from DENV-3__HM756274__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacgccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12647 - RNA, 9873 nt, Artificial Sequence
  derived and/or modified CDS sequence (opt2) from DENV-3__HM756275__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12648 - RNA, 9873 nt, Artificial Sequence
  derived and/or modified CDS sequence (opt2) from DENV-3__JF937632__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaucggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagcgcgccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcccccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccaccgccucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12649 - RNA, 9873 nt, Artificial Sequence
  derived and/or modified CDS sequence (opt2) from DENV-3__HM756281__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccaaggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuuccgcgagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12650 - RNA, 9873 nt, Artificial Sequence
  derived and/or modified CDS sequence (opt2) from DENV-3__JF937643__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagaaggccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucgcccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucgccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccgucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgacgacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12651 - RNA, 9873 nt, Artificial Sequence
  derived and/or modified CDS sequence (opt2) from DENV-3__HM181972__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucguccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccuggggcaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12652 - RNA, 9873 nt, Artificial Sequence
  derived and/or modified CDS sequence (opt2) from DENV-3__HM631857__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacaccgcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgccgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccgucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgucgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12653 - RNA, 9873 nt, Artificial Sequence
  derived and/or modified CDS sequence (opt2) from DENV-3__HM631860__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccaaggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccuacuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12654 - RNA, 9873 nt, Artificial Sequence
  derived and/or modified CDS sequence (opt2) from DENV-3__HM181977__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccaaggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12655 - RNA, 9873 nt, Artificial Sequence
  derived and/or modified CDS sequence (opt2) from DENV-3__HM181978__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccuccgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12656 - RNA, 9873 nt, Artificial Sequence
  derived and/or modified CDS sequence (opt2) from DENV-3__JN183884__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaagaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12657 - RNA, 9873 nt, Artificial Sequence
  derived and/or modified CDS sequence (opt2) from DENV-3__HQ541785__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucgccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucaccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgacgacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12658 - RNA, 9873 nt, Artificial Sequence
  derived and/or modified CDS sequence (opt2) from DENV-3__HM181975__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugauccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12659 - RNA, 9873 nt, Artificial Sequence
  derived and/or modified CDS sequence (opt2) from DENV-3__HM631864__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagaaggccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuccaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucgccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccgucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgacgacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12660 - RNA, 9873 nt, Artificial Sequence
  derived and/or modified CDS sequence (opt2) from DENV-3__HM631859__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggcgccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12661 - RNA, 9870 nt, Artificial Sequence
  derived and/or modified CDS sequence (opt2) from DENV-3__HM631856__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccaaggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguuccgcaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12662 - RNA, 9873 nt, Artificial Sequence
  derived and/or modified CDS sequence (opt2) from DENV-3__HM756276__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12663 - RNA, 9873 nt, Artificial Sequence
  derived and/or modified CDS sequence (opt2) from DENV-3__HM756279__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaccgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaacuucugggagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccucaccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12664 - RNA, 9873 nt, Artificial Sequence
  derived and/or modified CDS sequence (opt2) from DENV-3__HQ891025__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucaugaacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12665 - RNA, 9873 nt, Artificial Sequence
  derived and/or modified CDS sequence (opt2) from DENV-3__HQ705617__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuuccgcauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12666 - RNA, 9873 nt, Artificial Sequence
  derived and/or modified CDS sequence (opt2) from DENV-3__HQ705619__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccucaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12667 - RNA, 9873 nt, Artificial Sequence
  derived and/or modified CDS sequence (opt2) from DENV-3__HQ705620__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccugggucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgccgccucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagcgcaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12668 - RNA, 9873 nt, Artificial Sequence
  derived and/or modified CDS sequence (opt2) from DENV-3__HQ705621__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcaccacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12669 - RNA, 9873 nt, Artificial Sequence
  derived and/or modified CDS sequence (opt2) from DENV-3__HQ671176__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucgucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12670 - RNA, 9873 nt, Artificial Sequence
  derived and/or modified CDS sequence (opt2) from DENV-3__HQ705609__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccaaggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaucgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuuccgcgagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12671 - RNA, 9873 nt, Artificial Sequence
  derived and/or modified CDS sequence (opt2) from DENV-3__HQ705610__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacaccaucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuuccucaccuucguccuccuccucuccggccagaucaccuggaaggacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuccacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12672 - RNA, 9873 nt, Artificial Sequence
  derived and/or modified CDS sequence (opt2) from DENV-3__HQ705611__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagaagaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12673 - RNA, 9873 nt, Artificial Sequence
  derived and/or modified CDS sequence (opt2) from DENV-3__HQ705612__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaccaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12674 - RNA, 9873 nt, Artificial Sequence
  derived and/or modified CDS sequence (opt2) from DENV-3__HQ705613__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuaccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccacccgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12675 - RNA, 9873 nt, Artificial Sequence
  derived and/or modified CDS sequence (opt2) from DENV-3__HQ705615__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucgccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucaccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuaccacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgacgacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12676 - RNA, 9873 nt, Artificial Sequence
  derived and/or modified CDS sequence (opt2) from DENV-3__JF920398__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacaccaucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12677 - RNA, 9873 nt, Artificial Sequence
  derived and/or modified CDS sequence (opt2) from DENV-3__JF920402__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcgcccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12678 - RNA, 9873 nt, Artificial Sequence
  derived and/or modified CDS sequence (opt2) from DENV-3__JF937652__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacaacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccguccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcucgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaagcucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagaaggacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacaugggcgcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12679 - RNA, 9873 nt, Artificial Sequence
  derived and/or modified CDS sequence (opt2) from DENV-3__JF920404__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacgccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggagggcgccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12680 - RNA, 9873 nt, Artificial Sequence
  derived and/or modified CDS sequence (opt2) from DENV-3__JF937641__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacgccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12681 - RNA, 9873 nt, Artificial Sequence
  derived and/or modified CDS sequence (opt2) from DENV-3__JF920396__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcgcccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12682 - RNA, 9873 nt, Artificial Sequence
  derived and/or modified CDS sequence (opt2) from DENV-3__JF920406__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacgccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucgagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12683 - RNA, 9873 nt, Artificial Sequence
  derived and/or modified CDS sequence (opt2) from DENV-3__JF920409__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucgcccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgccuucuucauguucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgaguccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12684 - RNA, 9873 nt, Artificial Sequence
  derived and/or modified CDS sequence (opt2) from DENV-3__JF920408__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacggcacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccggcaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggaggucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccgacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12685 - RNA, 9873 nt, Artificial Sequence
  derived and/or modified CDS sequence (opt2) from DENV-3__JF920397__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggaccuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12686 - RNA, 9873 nt, Artificial Sequence
  derived and/or modified CDS sequence (opt2) from DENV-3__JN093513__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacaccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12687 - RNA, 9873 nt, Artificial Sequence
  derived and/or modified CDS sequence (opt2) from DENV-3__JF937624__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaucaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcaucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12688 - RNA, 9873 nt, Artificial Sequence
  derived and/or modified CDS sequence (opt2) from DENV-3__JN000938__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccuucuccgagaaggaggagaacauggucaagucccucgucuccgccggcggcggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12689 - RNA, 9873 nt, Artificial Sequence
  derived and/or modified CDS sequence (opt2) from DENV-3__JN093515__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagcgcgaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacaucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucaaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12690 - RNA, 9873 nt, Artificial Sequence
  derived and/or modified CDS sequence (opt2) from DENV-3__JF937646__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcaucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacgccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggucaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggucggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12691 - RNA, 9873 nt, Artificial Sequence
  derived and/or modified CDS sequence (opt2) from DENV-3__JF937633__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucacccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12692 - RNA, 9873 nt, Artificial Sequence
  derived and/or modified CDS sequence (opt2) from DENV-3__JF937634__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgucaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggaggucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccgacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12693 - RNA, 9873 nt, Artificial Sequence
  derived and/or modified CDS sequence (opt2) from DENV-3__JF937636__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcauccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccauccgccgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12694 - RNA, 9873 nt, Artificial Sequence
  derived and/or modified CDS sequence (opt2) from DENV-3__JF937626__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaugaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucguccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12695 - RNA, 9873 nt, Artificial Sequence
  derived and/or modified CDS sequence (opt2) from DENV-3__JF937621__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagcgcgccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12696 - RNA, 9873 nt, Artificial Sequence
  derived and/or modified CDS sequence (opt2) from DENV-3__JF937623__SS-prME
gccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcaucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaugaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcaucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12697 - RNA, 9873 nt, Artificial Sequence
  derived and/or modified CDS sequence (opt2) from DENV-3__JF937637__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacgccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccuccucaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12698 - RNA, 9873 nt, Artificial Sequence
  derived and/or modified CDS sequence (opt2) from DENV-3__JF937638__SS-prME
accucccucugccuccucaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgccgccucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccgcuccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagcgcaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucacccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaaccucaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagaucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12699 - RNA, 9873 nt, Artificial Sequence
  derived and/or modified CDS sequence (opt2) from DENV-3__JF937639__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacucccgcaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggccuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacaccaucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagaccaagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12700 - RNA, 9873 nt, Artificial Sequence
  derived and/or modified CDS sequence (opt2) from DENV-3__JF937627__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagcgcgaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccaugugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacaucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucaacaaggagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12701 - RNA, 9873 nt, Artificial Sequence
  derived and/or modified CDS sequence (opt2) from DENV-3__KF973476__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaucggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgccgccucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcggcggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucacccgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccgucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagcgcaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaaccccuaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12702 - RNA, 9873 nt, Artificial Sequence
  derived and/or modified CDS sequence (opt2) from DENV-3__KF973478__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccucccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccaccgccucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12703 - RNA, 9873 nt, Artificial Sequence
  derived and/or modified CDS sequence (opt2) from DENV-3__KF973479__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaaccucggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccuccgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12704 - RNA, 9873 nt, Artificial Sequence
  derived and/or modified CDS sequence (opt2) from DENV-3__KF973480__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagaucuucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucgcccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12705 - RNA, 9873 nt, Artificial Sequence
  derived and/or modified CDS sequence (opt2) from DENV-3__KF973481__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccaucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccgucggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12706 - RNA, 9873 nt, Artificial Sequence
  derived and/or modified CDS sequence (opt2) from DENV-3__KF973482__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccaucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccgucggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaccaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12707 - RNA, 9873 nt, Artificial Sequence
  derived and/or modified CDS sequence (opt2) from DENV-3__KF973483__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacucccgcaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgucggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgagaccuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacaccaucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12708 - RNA, 9873 nt, Artificial Sequence
  derived and/or modified CDS sequence (opt2) from DENV-3__KF973485__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaacaagaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgagguccacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggaagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgucguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggaggucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacaugguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccgacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12709 - RNA, 9873 nt, Artificial Sequence
  derived and/or modified CDS sequence (opt2) from DENV-3__KF973486__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucggccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgccccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggacuucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12710 - RNA, 9873 nt, Artificial Sequence
  derived and/or modified CDS sequence (opt2) from DENV-3__FJ898458__SS-prME
accucccucugccucaugaugauccuccccgccgcccucgccuuccaccucaccucccgcgacggcgagccccgcaugaucgucggcaagaacgagcgcggcaagacccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggaagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12711 - RNA, 9873 nt, Artificial Sequence
  derived and/or modified CDS sequence (opt2) from DENV-3__KJ189256__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12712 - RNA, 9873 nt, Artificial Sequence
  derived and/or modified CDS sequence (opt2) from DENV-3__KJ189257__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacaccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccgucuuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12713 - RNA, 9873 nt, Artificial Sequence
  derived and/or modified CDS sequence (opt2) from DENV-3__KJ189262__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccaucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12714 - RNA, 9873 nt, Artificial Sequence
  derived and/or modified CDS sequence (opt2) from DENV-3__KJ189263__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccguccucaucaaggucgaguacaagggcgaggacguccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12715 - RNA, 9873 nt, Artificial Sequence
  derived and/or modified CDS sequence (opt2) from DENV-3__KJ189265__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcacggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacaccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccaacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12716 - RNA, 9873 nt, Artificial Sequence
  derived and/or modified CDS sequence (opt2) from DENV-3__KJ189266__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccaucgagcccggcaagaaccccaagaacuuccaggccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12717 - RNA, 9873 nt, Artificial Sequence
  derived and/or modified CDS sequence (opt2) from DENV-3__KJ189268__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcaccaagaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12718 - RNA, 9873 nt, Artificial Sequence
  derived and/or modified CDS sequence (opt2) from DENV-3__KJ189271__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaagcucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12719 - RNA, 9873 nt, Artificial Sequence
  derived and/or modified CDS sequence (opt2) from DENV-3__KJ189272__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugccccuacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucuccaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12720 - RNA, 9873 nt, Artificial Sequence
  derived and/or modified CDS sequence (opt2) from DENV-3__KJ189273__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggucacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12721 - RNA, 9873 nt, Artificial Sequence
  derived and/or modified CDS sequence (opt2) from DENV-3__KJ189274__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggccgccgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaucuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcauccgcgaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12722 - RNA, 9873 nt, Artificial Sequence
  derived and/or modified CDS sequence (opt2) from DENV-3__KJ189275__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggccgccgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcauccgcgaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12723 - RNA, 9873 nt, Artificial Sequence
  derived and/or modified CDS sequence (opt2) from DENV-3__KJ189276__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccuccagugcuccccccgcaccggccucgacuucaacgagaugauccuccucaccaugaagaacaaggccuggaugguccaccgccagugguucuucgaccucccccuccccuggaccuccggcgccaccuccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccaguggaacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccgccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12724 - RNA, 9873 nt, Artificial Sequence
  derived and/or modified CDS sequence (opt2) from DENV-3__KJ189277__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccuccagugcuccccccgcaccggccucgacuucaacgagaugauccuccucaccaugaagaacaaggccuggaugguccaccgccagugguucuucgaccucccccuccccuggaccuccggcgccaccuccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggccuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccaguggaacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccgccucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12725 - RNA, 9873 nt, Artificial Sequence
  derived and/or modified CDS sequence (opt2) from DENV-3__KJ189278__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaccaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacgucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12726 - RNA, 9873 nt, Artificial Sequence
  derived and/or modified CDS sequence (opt2) from DENV-3__KJ189279__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggucacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccaucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12727 - RNA, 9873 nt, Artificial Sequence
  derived and/or modified CDS sequence (opt2) from DENV-3__KJ189280__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucuccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12728 - RNA, 9873 nt, Artificial Sequence
  derived and/or modified CDS sequence (opt2) from DENV-3__KJ189281__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucguccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12729 - RNA, 9873 nt, Artificial Sequence
  derived and/or modified CDS sequence (opt2) from DENV-3__KJ189282__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggccuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccauggccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12730 - RNA, 9873 nt, Artificial Sequence
  derived and/or modified CDS sequence (opt2) from DENV-3__KJ189283__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaagaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuuccgcaaggaggaggaguccgagggcgccaucugguga

SEQ ID NO: 12731 - RNA, 9873 nt, Artificial Sequence
  derived and/or modified CDS sequence (opt2) from DENV-3__KJ189284__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggucacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12732 - RNA, 9873 nt, Artificial Sequence
  derived and/or modified CDS sequence (opt2) from DENV-3__KJ189286__SS-prME
accuccuucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucaaccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12733 - RNA, 9873 nt, Artificial Sequence
  derived and/or modified CDS sequence (opt2) from DENV-3__KJ189287__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcaacauggcccacacccucaucaugaucggcuccaacgccuccgaccgcaugggcaugggcgucaccuaccucgcccucaucgccaccuucaagauccagcccuuccucguccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccauggccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12734 - RNA, 9873 nt, Artificial Sequence
  derived and/or modified CDS sequence (opt2) from DENV-3__KJ189288__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaccaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaagaugguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacgucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggccuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucguccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12735 - RNA, 9873 nt, Artificial Sequence
  derived and/or modified CDS sequence (opt2) from DENV-3__KJ189289__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucuccuccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaagaccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12736 - RNA, 9873 nt, Artificial Sequence
  derived and/or modified CDS sequence (opt2) from DENV-3__KJ189290__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcaacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagcgcuccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12737 - RNA, 9873 nt, Artificial Sequence
  derived and/or modified CDS sequence (opt2) from DENV-3__KJ189291__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcaacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagcgcuccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggacccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12738 - RNA, 9873 nt, Artificial Sequence
  derived and/or modified CDS sequence (opt2) from DENV-3__KJ189292__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggccgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucaugaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcaucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccauccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggcuccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgucgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagauccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12739 - RNA, 9873 nt, Artificial Sequence
  derived and/or modified CDS sequence (opt2) from DENV-3__KJ189293__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12740 - RNA, 9873 nt, Artificial Sequence
  derived and/or modified CDS sequence (opt2) from DENV-3__KJ189294__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12741 - RNA, 9873 nt, Artificial Sequence
  derived and/or modified CDS sequence (opt2) from DENV-3__KJ189295__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccuccucaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggaccgcacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12742 - RNA, 9873 nt, Artificial Sequence
  derived and/or modified CDS sequence (opt2) from DENV-3__KJ189297__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucucccagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12743 - RNA, 9873 nt, Artificial Sequence
  derived and/or modified CDS sequence (opt2) from DENV-3__KJ189298__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcaacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgaggagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12744 - RNA, 9873 nt, Artificial Sequence
  derived and/or modified CDS sequence (opt2) from DENV-3__KJ189301__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaccaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccacccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccacggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacgucaagcucaccgucgucgucggcgacaucaucggcguccucgagcgcggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcuccgccuccgcgaggccuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccacccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucguccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12745 - RNA, 9873 nt, Artificial Sequence
  derived and/or modified CDS sequence (opt2) from DENV-3__KF955456__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucgucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccauccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12746 - RNA, 9873 nt, Artificial Sequence
  derived and/or modified CDS sequence (opt2) from DENV-3__KF955465__SS-prME
accucccucugcaucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugguccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12747 - RNA, 9873 nt, Artificial Sequence
  derived and/or modified CDS sequence (opt2) from DENV-3__KF955466__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaugcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12748 - RNA, 9873 nt, Artificial Sequence
  derived and/or modified CDS sequence (opt2) from DENV-3__KF955468__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauccucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggccgcgucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggacccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12749 - RNA, 9873 nt, Artificial Sequence
  derived and/or modified CDS sequence (opt2) from DENV-3__FJ744726__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagauggacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagaaggacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12750 - RNA, 9873 nt, Artificial Sequence
  derived and/or modified CDS sequence (opt2) from DENV-3__FJ744729__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucaagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagauggacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugcgcuccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12751 - RNA, 9873 nt, Artificial Sequence
  derived and/or modified CDS sequence (opt2) from DENV-3__FJ687448__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagauggacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12752 - RNA, 9873 nt, Artificial Sequence
  derived and/or modified CDS sequence (opt2) from DENV-3__FJ744732__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagauggacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12753 - RNA, 9873 nt, Artificial Sequence
  derived and/or modified CDS sequence (opt2) from DENV-3__FJ810414__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggccaagucccucgucuccgccggcuccggcaagauggacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12754 - RNA, 9873 nt, Artificial Sequence
  derived and/or modified CDS sequence (opt2) from DENV-3__FJ744734__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagauggacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaugggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12755 - RNA, 9873 nt, Artificial Sequence
  derived and/or modified CDS sequence (opt2) from DENV-3__FJ744737__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagauggacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12756 - RNA, 9873 nt, Artificial Sequence
  derived and/or modified CDS sequence (opt2) from DENV-3__FJ744739__SS-prME
accucccucugccucaugaugaugcuccccgccacccucgccuuccaccucaccucccgcgacggcgagccccgcaugaucgucgccaagaacgagcgcggcaagucccuccucuucaagaccgucuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaagauggacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcuccuucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12757 - RNA, 9873 nt, Artificial Sequence
  derived and/or modified CDS sequence (opt2) from DENV-3__FJ744740__SS-prME
accucccucugccucaugaugaugcuccccgccacccucgccuuccaccucaccucccgcgacggcgagccccgcaugaucgucgccaagaacgagcgcggcaagucccuccucuucaagaccgccuccggcaucaacaugugcacccucaucgccauggaccucggcgagaugugcgacgacaccgucaccuacaagugcccccucaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccaucgccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccagcacgagaaccucaaguacaccgucaucaucaccguccacaccggcgaccagcaccaggucggcaacgacacccagggcgucaccgucgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcgucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccaguccugcgaccaccgccucauguccgccgccaucaaggacgagcgcgccguccacgccgacaugggcuacuggaucgagucccagaagaacggcuccuggaagcucgagaaggccuccuucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgucuccgccggcuccggcaaggucgacaacuucaccaugggcauccucugccucgccauccucuucgaggaggucaugcgcggcaaguucggcaagaagcacaugaucgccggcguccucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucaugacccucaagcucaucacccaguucgagaccuaccagcucuggaccgcccucgucucccucaccugcuccaacaccaucuucacccucaccgucgccuggcgcaccgccacccucauccucgccggcgucucccuccucccccucugccaguccuccuccaugcgcaagaccgacuggcuccccaugaccgucgccgccaugggcguccccccccucccccucuucaucuucucccucaaggacacccccaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaucaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgaggccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgucuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucaccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacuccuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggucgaccucgagaacccccaccuccucgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcgacgaggaguuccucgacuacaugcccuccaugaagcgcuuccgcaaggaggaggaguccgagggcgccaucugguga

SEQ ID NO: 12758 - RNA, 9873 nt, Artificial Sequence
  derived and/or modified CDS sequence (opt2) from DENV-3__GQ868593__SS-prME
accucccucugccucaugaugaugcuccccgccacccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucauccucgucacccccuccauggccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccauccuccccgaggagcaggaccagaacuacgucugcaagcacaccuacgucgaccgcggcuggggcaacggcugcggccucuucggcaagggcucccucgucaccugcgccaaguuccagugccucgaguccaucgagggcaaggucguccagcacgagaaccucaaguacaccgucaucaucaccguccacaccggcgaccagcaccaggucggcaacgagacccagggcgucaccgccgagaucaccccccaggccuccaccgucgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugccucaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaaggcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccuggaucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucaacgagaaggaggagaacauggucaagucccucgccuccgccggcuccggcaaggucgacaacuucaccaugggcguccucugccucgccauccucuucgaggaggucaugcgcggcaaguucggcaagaagcacaugaucgccggcguccuccucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucgucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucacccacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgucggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggcgagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgacgucccccuccaguggaucgccuccgccaucguccucgaguucuucaugaugguccuccucauccccgagcccgagaagcagcgcaccccccaggacaaccagcucgccuacgucgucaucggcauccucacccucgccgccaucgucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucgccacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccgccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucuccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucauccagauggccaugaccgacaccacccccuucggccagcagcgcgucuucaaggagaaggucgacacccgcaccccccgccccaugcccggcacccgcaaggucauggagaucaccgccgaguggcucuggcgcacccucggccgcaacaagcgcccccgccucugcacccgcgaggaguucaccaagaagguccgcaccaacgccgccaugggcgccgucuucaccgaggagaaccagugggacuccgcccgcgccgccgucgaggacgaggaguucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaagggcaccgucauggacaucaucucccgcaaggaccagcgcggcuccggccaggucggcaccuacggccucaacaccuucaccaacauggaggcccagcucguccgccagauggagggcgagggcguccucuccaaggccgaccucgagaacccccaccuccucgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccucaaggagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggaggacguccccuaccucggcaagcgcgaggaccaguggugcggcucccucaucggccucaccucccgcgccaccugggcccagaacauccucaccgccauccagcagguccgcucccucaucggcaacgaggaguuccucgacuacaugcccuccaugaagcgcuucaagaaggaggaggaguccgagggcgccaucugguga

SEQ ID NO: 12759 - RNA, 9873 nt, Artificial Sequence
  derived and/or modified CDS sequence (opt2) from DENV-3__FJ898459__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagguccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12760 - RNA, 9873 nt, Artificial Sequence
  derived and/or modified CDS sequence (opt2) from DENV-3__EU482555__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgaccucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgacaagaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12761 - RNA, 9873 nt, Artificial Sequence
  derived and/or modified CDS sequence (opt2) from DENV-3__EU529692__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgaccucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgacaagaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccgucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12762 - RNA, 9873 nt, Artificial Sequence
  derived and/or modified CDS sequence (opt2) from DENV-3__EU482558__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacaccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12763 - RNA, 9873 nt, Artificial Sequence
  derived and/or modified CDS sequence (opt2) from DENV-3__EU482563__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12764 - RNA, 9873 nt, Artificial Sequence
  derived and/or modified CDS sequence (opt2) from DENV-3__EU529696__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgaccucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgacaagaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccgucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12765 - RNA, 9873 nt, Artificial Sequence
  derived and/or modified CDS sequence (opt2) from DENV-3__EU529697__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccgcccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucacccaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucaacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12766 - RNA, 9873 nt, Artificial Sequence
  derived and/or modified CDS sequence (opt2) from DENV-3__EU482564__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagauccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgaccucgacuucaacuacugcgagggcaccaccgucgucaucaccgagaacugcggcacccgccgccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgacaagaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccgucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12767 - RNA, 9873 nt, Artificial Sequence
  derived and/or modified CDS sequence (opt2) from DENV-3__EU529699__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccgucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12768 - RNA, 9873 nt, Artificial Sequence
  derived and/or modified CDS sequence (opt2) from DENV-3__EU482566__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcaccaagggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12769 - RNA, 9873 nt, Artificial Sequence
  derived and/or modified CDS sequence (opt2) from DENV-3__EU529702__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacgucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagguccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucuccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcgcccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggacccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12770 - RNA, 9873 nt, Artificial Sequence
  derived and/or modified CDS sequence (opt2) from DENV-3__EU529703__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccgcccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagucccaccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12771 - RNA, 9873 nt, Artificial Sequence
  derived and/or modified CDS sequence (opt2) from DENV-3__EU529705__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcaucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucggccucaagggcauguccuacgccaugugcaccaacaccuucguccucaagaaggaggucuccgagacccagcacggcaccauccucaucaaggucgaguacaagggcgaggacguccccugcaagguccccuucuccaccgaggacggccagggcaaggcccacuccggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaaggccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccuccgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12772 - RNA, 9873 nt, Artificial Sequence
  derived and/or modified CDS sequence (opt2) from DENV-3__EU596492__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccgcccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucaacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaugccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12773 - RNA, 9873 nt, Artificial Sequence
  derived and/or modified CDS sequence (opt2) from DENV-3__EU596493__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucaacgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaaguacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12774 - RNA, 9873 nt, Artificial Sequence
  derived and/or modified CDS sequence (opt2) from DENV-3__EU596494__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcuccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccacccgcuccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12775 - RNA, 9873 nt, Artificial Sequence
  derived and/or modified CDS sequence (opt2) from DENV-3__EU687218__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagaaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12776 - RNA, 9873 nt, Artificial Sequence
  derived and/or modified CDS sequence (opt2) from DENV-3__EU726772__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagggccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12777 - RNA, 9873 nt, Artificial Sequence
  derived and/or modified CDS sequence (opt2) from DENV-3__FJ182013__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacgucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12778 - RNA, 9873 nt, Artificial Sequence
  derived and/or modified CDS sequence (opt2) from DENV-3__EU781136__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12779 - RNA, 9873 nt, Artificial Sequence
  derived and/or modified CDS sequence (opt2) from DENV-3__EU781137__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucgucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12780 - RNA, 9873 nt, Artificial Sequence
  derived and/or modified CDS sequence (opt2) from DENV-3__EU726773__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagaaggacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12781 - RNA, 9873 nt, Artificial Sequence
  derived and/or modified CDS sequence (opt2) from DENV-3__EU726774__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucauggucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaccacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12782 - RNA, 9873 nt, Artificial Sequence
  derived and/or modified CDS sequence (opt2) from DENV-3__EU687219__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucaucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12783 - RNA, 9873 nt, Artificial Sequence
  derived and/or modified CDS sequence (opt2) from DENV-3__EU726768__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12784 - RNA, 9873 nt, Artificial Sequence
  derived and/or modified CDS sequence (opt2) from DENV-3__EU687226__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccgucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcacaagcagacccagcgcuccggcguccccugggacguccccuccccccccgagacccagaaggccgagcucgaggagggcgucuaccgcaucaagcagcagggcaucuucggcaagacccaggucggcgucggcguccagaaggagggcgucuuccacuccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12785 - RNA, 9876 nt, Artificial Sequence
  derived and/or modified CDS sequence (opt2) from DENV-3__EU687233__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccugccacuccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12786 - RNA, 9873 nt, Artificial Sequence
  derived and/or modified CDS sequence (opt2) from DENV-3__EU687234__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagguccccuucuccaccgaggacggccagggcaaggcccacuccggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccuccgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12787 - RNA, 9873 nt, Artificial Sequence
  derived and/or modified CDS sequence (opt2) from DENV-3__EU687196__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucaucuucaccuucguccuccuccucuccggccagaucaccuggcgcgacgucgcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaccacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaucuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacauguccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccguccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaucuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcugguccuuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12788 - RNA, 9873 nt, Artificial Sequence
  derived and/or modified CDS sequence (opt2) from DENV-3__EU854298__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgagguccacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucgccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccauccccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccaccagguccgcucccucaucggcaacgaggaguuccucgacuacaugcccuccaugaagcgcuuccgcaaggaggaggagcucgagggcgccaucugguga

SEQ ID NO: 12789 - RNA, 9873 nt, Artificial Sequence
  derived and/or modified CDS sequence (opt2) from DENV-3__FJ373306__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacgucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagguccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucuccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12790 - RNA, 9873 nt, Artificial Sequence
  derived and/or modified CDS sequence (opt2) from DENV-3__EU687197__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucgucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccaacgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucgccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggccgcaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagcgcaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggagguccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccaccagguccgcucccucaucggcaacgaggaguuccucgacuacaugcccuccaugaagcgcuuccgcaaggaggaggagcucgagggcgccaucugguga

SEQ ID NO: 12791 - RNA, 9873 nt, Artificial Sequence
  derived and/or modified CDS sequence (opt2) from DENV-3__EU687198__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcgucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagacccgccucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12792 - RNA, 9873 nt, Artificial Sequence
  derived and/or modified CDS sequence (opt2) from DENV-3__EU726769__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacauggucgccggcgucuucuucaccuucguccuccuccucuccggccagaucaccuggcgcgacauggcccacacccucaucauggucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggaucgccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugaccuaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaaggucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12793 - RNA, 9873 nt, Artificial Sequence
  derived and/or modified CDS sequence (opt2) from DENV-3__EU687239__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcgucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccgucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgucaucugguga

SEQ ID NO: 12794 - RNA, 9873 nt, Artificial Sequence
  derived and/or modified CDS sequence (opt2) from DENV-3__FJ182004__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12795 - RNA, 9873 nt, Artificial Sequence
  derived and/or modified CDS sequence (opt2) from DENV-3__FJ024465__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucgccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccaccgucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacucccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12796 - RNA, 9873 nt, Artificial Sequence
  derived and/or modified CDS sequence (opt2) from DENV-3__FJ024466__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguaccgcuuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgacaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccaccagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12797 - RNA, 9873 nt, Artificial Sequence
  derived and/or modified CDS sequence (opt2) from DENV-3__FJ024467__SS-prME
accucccucugccucaugaugguccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccagacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggagaugaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccgccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagaaggacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgccaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgagaacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12798 - RNA, 9873 nt, Artificial Sequence
  derived and/or modified CDS sequence (opt2) from DENV-3__FJ024468__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgacaagaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12799 - RNA, 9873 nt, Artificial Sequence
  derived and/or modified CDS sequence (opt2) from DENV-3__FJ024470__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccgcccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagucccaccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12800 - RNA, 9873 nt, Artificial Sequence
  derived and/or modified CDS sequence (opt2) from DENV-3__FJ024471__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccgcccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucaacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagucccaccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12801 - RNA, 9873 nt, Artificial Sequence
  derived and/or modified CDS sequence (opt2) from DENV-3__FJ182005__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagguccccuucuccaccgaggacggccagggcaaggcccacuccggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcauccuccucaccuggaucggccucaacuccaagaacaccuccauguccuucuccugcaucgucaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaaggccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggauccucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccuccgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12802 - RNA, 9873 nt, Artificial Sequence
  derived and/or modified CDS sequence (opt2) from DENV-3__FJ373302__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggccuacacccagcucugcgaccaccgccucauguccgccgccgucaaggacgagcgcgccguccacgccgacaugggcuacuggaucgagucccagaagaagggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcuccaagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12803 - RNA, 9873 nt, Artificial Sequence
  derived and/or modified CDS sequence (opt2) from DENV-3__FJ182007__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaccggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgaggacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggaucgccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagcgcaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12804 - RNA, 9873 nt, Artificial Sequence
  derived and/or modified CDS sequence (opt2) from DENV-3__FJ182008__SS-prME
accucccucugcaucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgacaagaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucaucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12805 - RNA, 9873 nt, Artificial Sequence
  derived and/or modified CDS sequence (opt2) from DENV-3__FJ182010__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucguccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcaggucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccgacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12806 - RNA, 9873 nt, Artificial Sequence
  derived and/or modified CDS sequence (opt2) from DENV-3__FJ182011__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgacaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccaccagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12807 - RNA, 9873 nt, Artificial Sequence
  derived and/or modified CDS sequence (opt2) from DENV-3__FJ182038__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccacccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgacaagaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaugggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaccaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12808 - RNA, 9873 nt, Artificial Sequence
  derived and/or modified CDS sequence (opt2) from DENV-3__FJ182041__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcacccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12809 - RNA, 9873 nt, Artificial Sequence
  derived and/or modified CDS sequence (opt2) from DENV-3__FJ390371__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucaccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12810 - RNA, 9873 nt, Artificial Sequence
  derived and/or modified CDS sequence (opt2) from DENV-3__FJ390372__SS-prME
accucccucugccucaugaugguccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacgcccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcgucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccauguucacccucaccgucgccuggcgcaccgccacccucauccucgccggcgucucccuccuccccgucugccaguccuccuccaugcgcaagaccgacuggcuccccauggccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacaucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcgucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagaaggacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggccgcgccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaccacccaccacgccgucucccgcggcaccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccaccagcgcgucuucaaggagaaggucgacacccgcaccccccgcuccaugcccggcccccgccgcgccaugggcaucaccgccgaguggcucuggcgcacccucggccgcaacaagaagccccgccucugcacccgcgaggaguucaccaagaagggccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgccaccgccggcugggacacccgcaucaccgaggacgaccuccacaacgaggagaagaucacccagcagauggaccccgaccaccgccagcucgccaccgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccuccgccgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12811 - RNA, 9873 nt, Artificial Sequence
  derived and/or modified CDS sequence (opt2) from DENV-3__FJ205870__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucgccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaccggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcauccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucuccauccuccccgucugccaguccuccuccaugcgcaaguccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccgccgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccccaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccucuccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12812 - RNA, 9873 nt, Artificial Sequence
  derived and/or modified CDS sequence (opt2) from DENV-3__FJ390373__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccgcggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaccacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgcccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12813 - RNA, 9873 nt, Artificial Sequence
  derived and/or modified CDS sequence (opt2) from DENV-3__FJ205871__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggccuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaccacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12814 - RNA, 9873 nt, Artificial Sequence
  derived and/or modified CDS sequence (opt2) from DENV-3__FJ390375__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaccaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaccacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12815 - RNA, 9873 nt, Artificial Sequence
  derived and/or modified CDS sequence (opt2) from DENV-3__FJ390376__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagcgcgaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaucuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12816 - RNA, 9873 nt, Artificial Sequence
  derived and/or modified CDS sequence (opt2) from DENV-3__FJ390377__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucacccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga

SEQ ID NO: 12817 - RNA, 9873 nt, Artificial Sequence
  derived and/or modified CDS sequence (opt2) from DENV-3__FJ547069__SS-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccguccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaaccucggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgccucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaacuaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccggcuccggcaaggucgacaacuucaccaugggcguccucugccucgccauccucuucgaggaggucaugcgcggcaaguucggcaagaagcacaugaucgccggcgucuucuucaccuucguccuccuccucuccggccagaucaccuggcgcgacauggcccacacccucaucaugaucggcuccaacgccuccgaccgcaugggcaugggcgucaccuaccucgcccucaucgccaccuucaagauccagcccuuccucgcccucggcuucuuccuccgcaagcucaccucccgcgagaaccuccuccucggcgucggccucgccauggccaccacccuccagcuccccgaggacaucgagcagauggccaacggcaucgcccucggccucauggcccucaagcucaucacccaguucgagaccuaccagcucuggaccgcccucaucucccucaccugcuccaacaccaucuucacccucaccgucgccuggcgcaccgccacccucauccucgccggcgucucccuccuccccgucugccaguccuccuccaugcgcaagaccgacuggcuccccaugaccgucgccgccaugggcguccccccccucccccucuucaucuucucccucaaggacacccucaagcgccgcuccuggccccucaacgagggcgucauggccgucggccucgucuccauccucgccuccucccuccuccgcaacgacguccccauggccggcccccucgucgccggcggccuccucaucgccugcuacgucaucaccggcaccuccgccgaccucaccgucgagaaggccgccgacgucaccugggaggaggaggccgagcagaccggcgucucccacaaccucaugaucaccgucgacgacgacggcaccaugcgcaucaaggacgacgagaccgagaacauccucaccguccuccucaagaccgcccuccucaucgucuccggcaucuuccccuacuccauccccgccacccuccucgucuggcacaccuggcagaagcagacccagcgcuccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggacuucgccgccggccgcaaguccaucgcccucgaccucgucaccgagaucggccgcguccccucccaccucgcccaccgcacccgcaacgcccucgacaaccucgucaugcuccacaccuccgagcacggcggcaaggccuaccgccacgccgucgaggagcuccccgagaccauggagacccuccuccuccucggccucaugauccuccucaccggcggcgccaugcucuuccucaucuccggcaagggcaucggcaagaccuccaucggccucaucugcgucaucgccuccuccggcaugcucuggauggccgagaucccccuccaguggaucgccuccgccaucguccucgaguucuucaugaugguccuccucauccccgagcccgagaagcagcgcaccccccaggacaaccagcucgccuacgucgucaucggcauccucacccucgccgccaucaucgccgccaacgagaugggccuccucgagaccaccaagcgcgaccucggcauguccaaggagcccggcgucgucucccccaccuccuaccucgacgucgaccuccaccccgccuccgccuggacccucuacgccgucgccaccaccgucaucacccccaugcuccgccacaccaucgagaacuccaccgccaacgucucccucgccgccaucgccaaccaggccgucguccucaugggccucgacaagggcuggcccaucuccaagauggaccucggcgucccccuccucgcccucggcugcuacucccaggucaacccccucacccucaccgccgccguccuccuccucaucacccacuacgccaucaucggccccggccuccaggccaaggccacccgcgaggcccagaagcgcaccgccgccggcaucaugaagaaccccaccgucgacggcaucaugaccaucgaccucgaccccgucaucuacgacuccaaguucgagaagcagcucggccaggucaugcuccucguccucugcgccguccagcuccuccucaugcgcaccuccugggcccucugcgaggcccucacccucgccaccggccccaucaccacccucugggagggcucccccggcaaguucuggaacaccaccaucgccgucuccauggccaacaucuuccgcggcuccuaccucgccggcgccggccucgccuucuccaucaugaaguccgucggcaccggcaagcgcggcaccggcucccagggcgagacccucggcgagaaguggaagaagaagcucaaccagcucucccgcaaggaguucgaccucuacaagaaguccggcaucaccgaggucgaccgcaccgaggccaaggagggccucaagcgcggcgagaucacccaccacgccgucucccgcggcuccgccaagcuccagugguucgucgagcgcaacauggucauccccgagggccgcgucaucgaccucggcugcggccgcggcggcugguccuacuacugcgccggccucaagaaggucaccgagguccgcggcuacaccaagggcggccccggccacgaggagcccguccccauguccaccuacggcuggaacaucgucaagcucauguccggcaaggacgucuucuaccucccccccgagaagugcgacacccuccucugcgacaucggcgaguccucccccucccccaccgucgaggagucccgcaccauccgcguccucaagauggucgagcccuggcucaagaacaaccaguucugcaucaagguccucaaccccuacaugcccaccgucaucgagcaccucgagcgccuccagcgcaagcacggcggcaugcucguccgcaacccccucucccgcaacuccacccacgagauguacuggaucuccaacggcaccggcaacaucgucgccuccgucaacauggucucccgccuccuccucaaccgcuucaccaugacccaccgccgccccaccaucgagaaggacgucgaccucggcgccggcacccgccacgucaacgccgagcccgagacccccaacauggacgucaucggcgagcgcaucaagcgcaucaaggaggagcacaacuccaccuggcacuacgacgacgagaaccccuacaagaccugggccuaccacggcuccuacgaggucaaggccaccggcuccgccuccuccaugaucaacggcgucgucaagcuccucaccaagcccugggacgucguccccauggucacccagauggccaugaccgacaccacccccuucggccagcagcgcgucuucaaggagaaggucgacacccgcaccccccgcuccaugcccggcacccgccgcgucaugggcaucaccgccgaguggcucuggcgcacccucggccgcaacaagaagccccgccucugcacccgcgaggaguucaccaagaagguccgcaccaacgccgccaugggcgccgucuucaccgaggagaaccagugggacuccgccaaggccgccgucgaggacgaggacuucuggaagcucgucgaccgcgagcgcgagcuccacaagcucggcaagugcggcuccugcgucuacaacaugaugggcaagcgcgagaagaagcucggcgaguucggcaaggccaagggcucccgcgccaucugguacauguggcucggcgcccgcuaccucgaguucgaggcccucggcuuccucaacgaggaccacugguucucccgcgagaacuccuacuccggcgucgagggcgagggccuccacaagcucggcuacauccuccgcgacaucuccaagauccccggcggcgccauguacgccgacgacaccgccggcugggacacccgcaucaccgaggacgaccuccacaacgaggagaagaucacccagcagauggaccccgagcaccgccagcucgccaacgccaucuucaagcucaccuaccagaacaaggucgucaagguccagcgccccacccccaccggcaccgucauggacaucaucucccgcaaggaccagcgcggcuccggccaggucggcaccuacggccucaacaccuucaccaacauggaggcccagcucauccgccagauggagggcgagggcguccucuccaaggccgaccucgagaacccccaccuccccgagaagaagaucacccaguggcucgagaccaagggcgucgagcgccucaagcgcauggccaucuccggcgacgacugcgucgucaagcccaucgacgaccgcuucgccaacgcccuccucgcccucaacgacaugggcaagguccgcaaggacaucccccaguggcagcccuccaagggcuggcacgacuggcagcagguccccuucugcucccaccacuuccacgagcucaucaugaaggacggccgcaagcucgucguccccugccgcccccaggacgagcucaucggccgcgcccgcaucucccagggcgccggcuggucccuccgcgagaccgccugccucggcaaggccuacgcccagauguggucccucauguacuuccaccgccgcgaccuccgccucgccuccaacgccaucugcuccgccguccccguccacuggguccccaccucccgcaccaccugguccauccacgcccaccaccaguggaugaccaccgaggacaugcucaccgucuggaaccgcgucuggaucgaggacaaccccuggauggaggacaagacccccgucaccaccugggagaacguccccuaccucggcaagcgcgaggaccaguggugcggcucccucaucggccucaccucccgcgccaccugggcccagaacauccccaccgccauccagcagguccgcucccucaucggcaacgaggaguuccucgacuacaugcccuccaugaagcgcuuccgcaaggaggaggaguccgagggcgccaucugguga
